United States Patent 12,247,232 (METHODS AND COMPOSITIONS FOR INHIBITING ADAM 9 BIOLOGICAL ACTIVITIES) - sequence listing, part 2

SEQ ID NO: 8544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 8545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 8546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 8547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 8548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 8549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 8550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 8551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 8552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 8553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 8554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 8555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 8556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 8557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 8558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 8559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 8560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 8561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 8562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 8563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 8564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 8565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 8566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 8567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 8568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 8569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 8570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 8571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 8572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 8573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 8574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 8575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 8576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 8577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 8578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 8579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 8580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 8581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 8582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 8583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 8584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 8585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 8586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 8587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 8588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 8589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 8590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 8591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 8592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 8593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 8594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 8595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 8596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 8597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 8598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 8599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 8600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 8601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 8602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 8603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 8604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 8605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 8606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 8607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 8608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 8609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 8610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 8611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 8612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 8613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 8614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 8615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 8616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 8617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 8618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 8619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 8620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 8621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 8622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 8623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 8624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 8625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 8626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 8627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 8628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 8629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 8630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 8631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 8632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 8633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 8634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 8635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 8636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 8637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 8638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 8639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 8640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 8641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 8642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 8643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 8644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 8645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 8646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 8647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 8648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 8649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 8650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 8651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 8652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 8653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 8654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 8655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 8656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 8657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 8658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 8659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 8660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 8661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 8662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 8663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 8664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 8665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 8666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 8667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 8668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 8669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 8670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 8671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 8672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 8673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 8674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 8675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 8676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 8677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 8678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 8679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 8680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 8681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 8682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 8683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 8684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 8685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 8686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 8687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 8688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 8689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 8690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 8691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 8692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 8693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 8694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 8695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 8696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 8697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 8698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 8699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 8700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 8701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 8702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 8703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 8704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 8705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 8706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 8707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 8708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 8709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 8710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 8711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 8712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 8713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 8714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 8715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 8716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 8717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 8718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 8719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 8720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 8721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 8722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 8723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 8724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 8725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 8726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 8727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 8728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 8729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 8730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 8731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 8732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 8733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 8734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 8735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 8736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 8737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 8738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 8739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 8740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 8741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 8742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 8743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 8744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 8745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 8746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 8747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 8748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 8749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 8750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 8751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 8752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 8753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 8754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 8755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 8756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 8757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 8758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 8759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 8760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 8761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 8762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 8763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 8764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 8765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 8766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 8767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 8768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 8769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 8770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 8771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 8772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 8773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 8774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 8775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 8776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 8777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 8778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 8779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 8780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 8781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 8782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 8783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 8784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 8785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 8786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 8787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 8788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 8789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 8790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 8791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 8792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 8793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 8794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 8795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 8796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 8797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 8798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 8799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 8800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 8801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 8802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 8803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 8804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 8805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 8806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 8807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 8808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 8809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 8810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 8811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 8812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 8813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 8814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 8815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 8816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 8817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 8818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 8819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 8820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 8821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 8822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 8823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 8824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 8825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 8826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 8827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 8828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 8829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 8830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 8831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 8832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 8833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 8834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 8835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 8836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 8837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 8838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 8839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 8840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 8841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 8842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 8843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 8844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 8845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 8846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 8847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 8848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 8849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 8850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 8851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 8852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 8853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 8854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 8855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 8856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 8857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 8858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 8859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 8860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 8861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 8862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 8863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 8864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 8865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 8866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 8867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 8868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 8869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 8870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 8871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 8872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 8873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 8874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 8875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 8876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 8877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 8878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 8879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 8880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 8881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 8882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 8883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 8884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 8885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 8886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 8887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 8888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 8889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 8890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 8891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 8892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 8893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 8894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 8895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 8896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 8897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 8898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 8899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 8900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 8901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 8902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 8903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 8904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 8905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 8906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 8907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 8908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 8909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 8910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 8911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 8912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 8913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 8914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 8915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 8916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 8917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 8918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 8919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 8920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 8921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 8922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 8923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 8924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 8925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 8926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 8927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 8928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 8929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 8930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 8931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 8932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 8933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 8934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 8935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 8936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 8937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 8938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 8939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 8940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 8941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 8942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 8943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 8944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 8945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 8946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 8947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 8948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 8949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 8950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 8951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 8952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 8953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 8954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 8955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 8956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 8957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 8958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 8959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 8960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 8961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 8962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 8963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 8964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 8965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 8966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 8967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 8968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 8969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 8970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 8971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 8972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 8973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 8974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 8975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 8976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 8977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 8978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 8979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 8980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 8981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 8982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 8983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 8984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 8985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 8986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 8987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 8988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 8989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 8990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 8991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 8992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 8993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 8994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 8995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 8996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 8997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 8998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 8999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 9000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 9001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 9002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 9003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 9004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 9005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 9006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 9007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 9008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 9009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 9010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 9011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 9012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 9013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 9014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 9015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 9016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 9017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 9018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 9019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 9020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 9021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 9022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 9023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 9024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 9025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 9026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 9027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 9028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 9029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 9030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 9031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 9032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 9033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 9034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 9035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 9036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 9037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 9038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 9039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 9040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 9041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 9042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 9043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 9044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 9045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 9046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 9047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 9048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 9049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 9050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 9051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 9052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 9053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 9054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 9055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 9056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 9057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 9058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 9059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 9060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 9061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 9062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 9063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 9064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 9065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 9066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 9067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 9068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 9069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 9070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 9071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 9072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 9073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 9074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 9075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 9076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 9077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 9078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 9079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 9080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 9081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 9082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 9083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 9084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 9085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 9086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 9087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 9088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 9089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 9090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 9091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 9092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 9093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 9094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 9095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 9096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 9097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 9098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 9099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 9100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 9101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 9102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 9103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 9104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 9105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 9106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 9107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 9108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 9109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 9110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 9111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 9112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 9113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 9114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 9115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 9116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 9117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 9118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 9119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 9120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 9121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 9122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 9123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 9124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 9125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 9126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 9127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 9128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 9129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 9130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 9131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 9132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 9133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 9134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 9135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 9136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 9137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 9138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 9139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 9140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 9141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 9142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 9143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 9144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 9145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 9146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 9147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 9148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 9149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 9150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 9151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 9152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 9153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 9154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 9155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 9156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 9157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 9158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 9159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 9160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 9161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 9162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 9163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 9164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 9165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 9166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 9167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 9168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 9169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 9170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 9171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 9172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 9173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 9174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 9175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 9176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 9177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 9178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 9179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 9180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 9181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 9182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 9183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 9184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 9185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 9186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 9187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 9188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 9189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 9190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 9191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 9192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 9193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 9194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 9195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 9196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 9197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 9198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 9199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 9200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 9201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 9202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 9203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 9204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 9205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 9206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 9207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 9208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 9209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 9210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 9211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 9212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 9213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 9214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 9215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 9216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 9217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 9218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 9219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 9220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 9221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 9222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 9223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 9224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 9225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 9226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 9227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 9228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 9229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 9230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 9231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 9232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 9233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 9234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 9235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 9236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 9237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 9238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 9239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 9240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 9241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 9242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 9243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 9244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 9245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 9246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 9247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 9248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 9249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 9250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 9251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 9252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 9253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 9254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 9255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 9256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 9257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 9258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 9259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 9260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 9261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 9262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 9263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 9264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 9265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 9266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 9267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 9268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 9269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 9270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 9271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 9272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 9273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 9274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 9275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 9276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 9277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 9278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 9279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 9280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 9281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 9282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 9283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 9284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 9285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 9286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 9287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 9288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 9289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 9290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 9291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 9292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 9293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 9294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 9295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 9296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 9297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 9298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 9299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 9300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 9301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 9302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 9303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 9304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 9305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 9306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 9307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 9308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 9309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 9310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 9311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 9312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 9313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 9314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 9315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 9316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 9317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 9318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 9319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 9320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 9321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 9322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 9323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 9324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 9325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 9326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 9327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 9328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 9329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 9330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 9331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 9332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 9333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 9334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 9335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 9336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 9337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 9338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 9339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 9340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 9341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 9342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 9343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 9344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 9345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 9346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 9347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 9348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 9349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 9350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 9351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 9352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 9353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 9354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 9355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 9356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 9357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 9358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 9359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 9360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 9361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 9362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 9363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 9364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 9365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 9366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 9367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 9368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 9369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 9370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 9371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 9372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 9373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 9374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 9375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 9376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 9377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 9378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 9379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 9380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 9381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 9382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 9383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 9384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 9385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 9386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 9387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 9388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 9389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 9390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 9391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 9392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 9393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 9394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 9395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 9396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 9397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 9398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 9399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 9400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 9401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 9402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 9403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 9404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 9405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 9406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 9407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 9408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 9409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 9410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 9411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 9412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 9413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 9414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 9415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 9416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 9417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 9418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 9419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 9420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 9421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 9422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 9423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 9424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 9425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 9426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 9427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 9428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 9429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 9430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 9431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 9432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 9433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 9434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 9435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 9436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 9437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 9438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 9439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 9440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 9441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 9442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 9443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 9444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 9445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 9446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 9447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 9448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 9449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 9450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 9451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 9452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 9453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 9454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 9455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 9456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 9457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 9458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 9459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 9460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 9461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 9462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 9463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 9464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 9465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 9466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 9467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 9468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 9469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 9470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 9471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 9472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 9473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 9474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 9475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 9476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 9477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 9478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 9479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 9480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 9481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 9482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 9483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 9484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 9485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 9486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 9487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 9488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 9489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 9490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 9491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 9492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 9493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 9494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 9495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 9496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 9497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 9498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 9499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 9500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 9501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 9502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 9503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 9504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 9505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 9506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 9507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 9508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 9509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 9510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 9511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 9512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 9513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 9514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 9515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 9516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 9517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 9518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 9519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 9520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 9521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 9522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 9523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 9524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 9525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 9526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 9527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 9528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 9529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 9530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 9531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 9532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 9533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 9534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 9535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 9536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 9537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 9538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 9539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 9540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 9541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 9542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 9543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 9544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 9545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 9546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 9547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 9548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 9549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 9550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 9551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 9552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 9553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 9554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 9555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 9556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 9557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 9558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 9559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 9560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 9561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 9562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 9563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 9564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 9565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 9566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 9567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 9568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 9569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 9570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 9571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 9572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 9573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 9574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 9575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 9576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 9577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 9578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 9579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 9580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 9581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 9582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 9583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 9584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 9585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 9586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 9587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 9588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 9589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 9590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 9591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 9592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 9593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 9594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 9595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 9596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 9597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 9598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 9599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 9600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 9601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 9602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 9603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 9604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 9605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 9606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 9607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 9608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 9609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 9610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 9611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 9612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 9613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 9614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 9615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 9616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 9617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 9618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 9619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 9620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 9621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 9622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 9623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 9624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 9625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 9626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 9627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 9628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 9629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 9630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 9631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 9632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 9633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 9634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 9635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 9636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 9637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 9638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 9639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 9640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 9641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 9642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 9643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 9644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 9645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 9646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 9647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 9648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 9649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 9650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 9651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 9652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 9653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 9654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 9655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 9656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 9657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 9658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 9659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 9660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 9661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 9662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 9663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 9664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 9665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 9666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 9667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 9668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 9669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 9670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 9671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 9672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 9673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 9674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 9675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 9676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 9677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 9678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 9679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 9680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 9681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 9682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 9683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 9684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 9685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 9686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 9687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 9688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 9689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 9690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 9691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 9692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 9693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 9694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 9695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 9696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 9697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 9698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 9699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 9700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 9701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 9702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 9703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 9704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 9705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 9706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 9707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 9708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 9709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 9710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 9711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 9712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 9713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 9714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 9715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 9716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 9717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 9718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 9719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 9720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 9721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 9722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 9723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 9724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 9725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 9726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 9727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 9728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 9729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 9730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 9731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 9732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 9733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 9734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 9735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 9736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 9737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 9738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 9739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 9740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 9741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 9742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 9743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 9744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 9745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 9746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 9747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 9748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 9749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 9750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 9751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 9752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 9753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 9754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 9755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 9756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 9757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 9758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 9759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 9760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 9761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 9762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 9763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 9764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 9765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 9766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 9767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 9768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 9769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 9770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 9771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 9772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 9773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 9774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 9775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 9776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 9777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 9778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 9779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 9780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 9781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 9782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 9783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 9784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 9785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 9786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 9787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 9788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 9789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 9790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 9791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 9792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 9793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 9794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 9795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 9796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 9797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 9798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 9799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 9800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 9801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 9802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 9803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 9804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 9805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 9806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 9807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 9808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 9809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 9810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 9811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 9812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 9813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 9814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 9815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 9816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 9817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 9818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 9819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 9820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 9821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 9822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 9823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 9824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 9825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 9826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 9827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 9828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 9829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 9830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 9831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 9832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 9833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 9834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 9835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 9836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 9837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 9838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 9839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 9840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 9841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 9842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 9843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 9844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 9845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 9846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 9847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 9848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 9849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 9850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 9851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 9852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 9853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 9854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 9855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 9856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 9857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 9858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 9859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 9860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 9861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 9862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 9863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 9864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 9865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 9866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 9867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 9868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 9869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 9870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 9871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 9872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 9873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 9874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 9875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 9876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 9877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 9878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 9879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 9880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 9881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 9882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 9883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 9884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 9885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 9886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 9887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 9888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 9889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 9890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 9891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 9892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 9893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 9894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 9895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 9896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 9897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 9898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 9899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 9900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 9901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 9902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 9903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 9904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 9905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 9906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 9907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 9908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 9909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 9910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 9911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 9912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 9913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 9914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 9915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 9916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 9917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 9918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 9919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 9920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 9921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 9922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 9923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 9924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 9925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 9926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 9927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 9928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 9929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 9930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 9931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 9932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 9933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 9934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 9935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 9936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 9937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 9938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 9939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 9940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 9941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 9942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 9943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 9944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 9945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 9946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 9947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 9948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 9949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 9950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 9951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 9952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 9953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 9954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 9955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 9956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 9957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 9958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 9959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 9960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 9961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 9962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 9963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 9964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 9965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 9966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 9967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 9968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 9969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 9970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 9971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 9972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 9973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 9974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 9975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 9976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 9977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 9978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 9979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 9980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 9981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 9982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 9983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 9984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 9985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 9986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 9987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 9988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 9989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 9990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 9991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 9992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 9993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 9994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 9995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 9996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 9997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 9998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 9999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 10000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 10001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 10002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 10003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 10004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 10005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 10006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 10007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 10008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 10009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 10010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 10011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 10012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 10013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 10014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 10015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 10016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 10017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 10018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 10019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 10020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 10021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 10022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 10023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 10024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 10025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 10026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 10027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 10028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 10029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 10030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 10031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 10032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 10033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 10034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 10035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 10036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 10037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 10038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 10039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 10040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 10041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 10042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 10043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 10044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 10045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 10046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 10047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 10048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 10049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 10050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 10051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 10052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 10053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 10054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 10055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 10056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 10057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 10058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 10059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 10060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 10061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 10062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 10063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 10064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 10065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 10066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 10067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 10068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 10069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 10070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 10071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 10072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 10073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 10074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 10075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 10076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 10077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 10078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 10079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 10080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 10081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 10082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 10083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 10084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 10085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 10086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 10087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 10088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 10089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 10090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 10091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 10092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 10093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 10094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 10095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 10096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 10097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 10098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 10099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 10100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 10101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 10102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 10103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 10104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 10105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 10106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 10107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 10108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 10109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 10110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 10111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 10112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 10113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 10114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 10115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 10116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 10117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 10118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 10119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 10120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 10121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 10122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 10123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 10124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 10125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 10126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 10127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 10128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 10129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 10130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 10131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 10132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 10133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 10134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 10135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 10136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 10137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 10138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 10139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 10140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 10141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 10142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 10143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 10144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 10145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 10146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 10147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 10148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 10149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 10150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 10151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 10152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 10153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 10154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 10155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 10156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 10157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 10158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 10159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 10160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 10161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 10162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 10163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 10164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 10165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 10166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 10167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 10168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 10169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 10170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 10171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 10172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 10173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 10174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 10175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 10176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 10177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 10178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 10179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 10180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 10181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 10182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 10183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 10184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 10185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 10186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 10187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 10188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 10189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 10190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 10191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 10192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 10193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 10194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 10195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 10196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 10197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 10198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 10199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 10200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 10201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 10202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 10203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 10204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 10205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 10206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 10207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 10208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 10209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 10210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 10211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 10212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 10213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 10214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 10215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 10216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 10217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 10218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 10219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 10220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 10221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 10222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 10223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 10224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 10225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 10226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 10227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 10228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 10229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 10230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 10231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 10232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 10233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 10234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 10235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 10236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 10237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 10238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 10239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 10240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 10241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 10242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 10243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 10244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 10245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 10246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 10247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 10248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 10249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 10250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 10251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 10252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 10253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 10254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 10255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 10256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 10257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 10258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 10259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 10260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 10261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 10262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 10263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 10264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 10265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 10266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 10267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 10268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 10269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 10270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 10271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 10272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 10273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 10274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 10275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 10276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 10277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 10278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 10279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 10280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 10281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 10282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 10283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 10284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 10285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 10286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 10287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 10288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 10289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 10290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 10291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 10292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 10293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 10294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 10295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 10296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 10297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 10298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 10299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 10300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 10301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 10302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 10303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 10304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 10305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 10306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 10307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 10308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 10309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 10310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 10311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 10312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 10313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 10314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 10315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 10316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 10317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 10318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 10319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 10320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 10321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 10322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 10323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 10324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 10325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 10326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 10327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 10328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 10329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 10330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 10331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 10332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 10333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 10334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 10335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 10336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 10337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 10338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 10339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 10340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 10341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 10342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 10343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 10344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 10345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 10346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 10347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 10348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 10349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 10350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 10351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 10352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 10353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 10354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 10355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 10356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 10357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 10358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 10359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 10360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 10361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 10362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 10363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 10364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 10365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 10366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 10367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 10368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 10369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 10370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 10371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 10372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 10373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 10374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 10375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 10376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 10377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 10378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 10379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 10380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 10381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 10382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 10383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 10384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 10385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 10386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 10387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 10388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 10389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 10390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 10391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 10392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 10393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 10394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 10395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 10396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 10397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 10398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 10399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 10400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 10401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 10402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 10403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 10404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 10405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 10406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 10407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 10408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 10409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 10410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 10411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 10412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 10413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 10414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 10415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 10416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 10417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 10418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 10419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 10420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 10421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 10422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 10423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 10424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 10425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 10426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 10427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 10428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 10429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 10430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 10431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 10432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 10433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 10434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 10435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 10436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 10437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 10438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 10439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 10440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 10441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 10442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 10443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 10444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 10445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 10446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 10447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 10448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 10449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 10450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 10451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 10452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 10453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 10454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 10455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 10456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 10457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 10458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 10459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 10460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 10461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 10462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 10463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 10464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 10465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 10466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 10467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 10468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 10469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 10470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 10471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 10472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 10473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 10474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 10475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 10476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 10477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 10478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 10479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 10480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 10481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 10482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 10483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 10484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 10485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 10486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 10487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 10488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 10489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 10490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 10491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 10492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 10493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 10494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 10495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 10496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 10497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 10498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 10499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 10500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 10501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 10502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 10503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 10504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 10505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 10506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 10507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 10508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 10509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 10510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 10511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 10512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 10513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 10514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 10515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 10516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 10517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 10518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 10519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 10520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 10521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 10522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 10523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 10524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 10525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 10526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 10527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 10528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 10529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 10530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 10531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 10532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 10533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 10534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 10535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 10536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 10537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 10538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 10539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 10540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 10541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 10542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 10543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 10544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 10545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 10546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 10547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 10548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 10549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 10550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 10551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 10552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 10553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 10554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 10555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 10556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 10557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 10558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 10559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 10560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 10561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 10562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 10563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 10564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 10565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 10566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 10567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 10568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 10569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 10570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 10571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 10572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 10573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 10574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 10575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 10576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 10577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 10578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 10579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 10580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 10581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 10582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 10583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 10584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 10585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 10586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 10587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 10588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 10589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 10590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 10591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 10592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 10593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 10594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 10595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 10596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 10597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 10598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 10599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 10600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 10601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 10602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 10603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 10604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 10605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 10606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 10607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 10608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 10609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 10610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 10611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 10612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 10613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 10614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 10615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 10616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 10617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 10618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 10619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 10620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 10621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 10622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 10623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 10624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 10625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 10626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 10627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 10628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 10629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 10630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 10631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 10632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 10633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 10634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 10635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 10636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 10637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 10638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 10639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 10640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 10641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 10642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 10643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 10644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 10645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 10646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 10647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 10648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 10649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 10650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 10651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 10652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 10653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 10654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 10655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 10656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 10657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 10658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 10659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 10660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 10661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 10662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 10663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 10664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 10665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 10666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 10667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 10668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 10669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 10670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 10671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 10672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 10673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 10674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 10675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 10676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 10677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 10678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 10679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 10680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 10681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 10682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 10683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 10684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 10685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 10686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 10687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 10688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 10689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 10690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 10691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 10692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 10693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 10694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 10695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 10696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 10697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 10698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 10699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 10700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 10701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 10702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 10703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 10704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 10705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 10706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 10707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 10708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 10709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 10710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 10711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 10712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 10713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 10714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 10715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 10716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 10717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 10718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 10719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 10720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 10721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 10722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 10723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 10724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 10725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 10726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 10727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 10728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 10729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 10730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 10731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 10732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 10733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 10734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 10735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 10736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 10737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 10738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 10739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 10740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 10741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 10742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 10743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 10744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 10745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 10746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 10747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 10748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 10749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 10750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 10751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 10752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 10753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 10754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 10755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 10756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 10757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 10758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 10759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 10760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 10761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 10762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 10763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 10764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 10765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 10766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 10767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 10768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 10769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 10770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 10771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 10772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 10773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 10774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 10775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 10776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 10777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 10778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 10779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 10780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 10781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 10782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 10783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 10784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 10785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 10786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 10787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 10788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 10789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 10790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 10791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 10792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 10793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 10794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 10795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 10796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 10797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 10798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 10799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 10800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 10801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 10802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 10803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 10804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 10805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 10806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 10807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 10808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 10809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 10810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 10811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 10812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 10813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 10814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 10815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 10816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 10817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 10818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 10819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 10820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 10821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 10822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 10823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 10824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 10825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 10826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 10827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 10828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 10829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 10830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 10831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 10832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 10833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 10834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 10835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 10836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 10837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 10838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 10839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 10840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 10841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 10842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 10843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 10844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 10845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 10846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 10847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 10848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 10849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 10850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 10851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 10852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 10853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 10854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 10855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 10856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 10857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 10858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 10859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 10860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 10861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 10862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 10863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 10864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 10865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 10866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 10867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 10868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 10869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 10870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 10871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 10872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 10873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 10874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 10875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 10876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 10877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 10878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 10879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 10880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 10881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 10882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 10883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 10884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 10885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 10886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 10887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 10888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 10889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 10890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 10891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 10892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 10893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 10894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 10895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 10896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 10897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 10898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 10899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 10900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 10901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 10902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 10903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 10904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 10905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 10906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 10907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 10908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 10909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 10910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 10911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 10912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 10913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 10914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 10915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 10916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 10917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 10918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 10919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 10920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 10921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 10922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 10923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 10924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 10925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 10926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 10927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 10928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 10929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 10930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 10931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 10932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 10933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 10934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 10935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 10936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 10937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 10938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 10939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 10940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 10941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 10942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 10943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 10944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 10945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 10946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 10947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 10948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 10949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 10950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 10951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 10952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 10953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 10954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 10955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 10956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 10957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 10958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 10959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 10960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 10961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 10962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 10963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 10964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 10965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 10966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 10967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 10968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 10969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 10970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 10971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 10972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 10973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 10974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 10975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 10976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 10977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 10978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 10979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 10980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 10981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 10982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 10983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 10984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 10985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 10986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 10987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 10988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 10989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 10990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 10991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 10992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 10993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 10994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 10995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 10996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 10997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 10998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 10999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 11000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 11001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 11002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 11003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 11004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 11005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 11006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 11007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 11008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 11009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 11010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 11011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 11012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 11013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 11014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 11015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 11016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 11017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 11018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 11019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 11020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 11021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 11022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 11023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 11024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 11025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 11026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 11027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 11028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 11029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 11030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 11031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 11032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 11033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 11034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 11035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 11036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 11037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 11038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 11039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 11040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 11041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 11042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 11043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 11044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 11045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 11046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 11047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 11048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 11049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 11050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 11051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 11052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 11053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 11054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 11055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 11056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 11057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 11058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 11059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 11060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 11061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 11062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 11063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 11064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 11065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 11066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 11067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 11068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 11069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 11070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 11071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 11072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 11073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 11074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 11075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 11076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 11077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 11078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 11079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 11080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 11081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 11082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 11083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 11084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 11085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 11086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 11087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 11088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 11089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 11090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 11091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 11092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 11093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 11094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 11095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 11096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 11097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 11098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 11099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 11100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 11101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 11102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 11103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 11104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 11105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 11106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 11107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 11108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 11109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 11110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 11111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 11112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 11113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 11114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 11115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 11116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 11117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 11118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 11119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 11120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 11121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 11122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 11123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 11124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 11125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 11126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 11127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 11128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 11129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 11130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 11131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 11132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 11133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 11134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 11135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 11136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 11137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 11138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 11139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 11140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 11141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 11142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 11143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 11144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 11145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 11146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 11147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 11148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 11149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 11150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 11151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 11152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 11153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 11154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 11155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 11156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 11157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 11158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 11159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 11160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 11161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 11162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 11163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 11164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 11165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 11166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 11167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 11168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 11169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 11170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 11171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 11172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 11173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 11174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 11175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 11176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 11177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 11178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 11179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 11180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 11181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 11182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 11183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 11184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 11185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 11186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 11187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 11188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 11189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 11190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 11191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 11192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 11193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 11194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 11195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 11196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 11197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 11198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 11199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 11200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 11201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 11202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 11203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 11204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 11205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 11206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 11207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 11208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 11209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 11210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 11211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 11212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 11213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 11214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 11215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 11216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 11217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 11218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 11219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 11220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 11221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 11222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 11223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 11224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 11225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 11226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 11227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 11228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 11229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 11230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 11231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 11232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 11233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 11234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 11235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 11236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 11237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 11238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 11239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 11240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 11241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 11242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 11243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 11244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 11245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 11246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 11247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 11248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 11249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 11250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 11251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 11252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 11253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 11254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 11255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 11256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 11257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 11258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 11259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 11260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 11261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 11262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 11263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 11264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 11265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 11266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 11267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 11268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 11269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 11270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 11271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 11272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 11273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 11274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 11275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 11276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 11277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 11278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 11279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 11280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 11281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 11282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 11283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 11284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 11285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 11286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 11287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 11288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 11289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 11290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 11291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 11292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 11293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 11294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 11295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 11296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 11297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 11298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 11299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 11300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 11301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 11302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 11303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 11304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 11305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 11306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 11307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 11308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 11309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 11310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 11311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 11312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 11313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 11314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 11315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 11316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 11317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 11318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 11319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 11320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 11321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 11322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 11323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 11324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 11325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 11326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 11327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 11328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 11329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 11330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 11331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 11332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 11333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 11334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 11335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 11336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 11337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 11338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 11339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 11340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 11341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 11342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 11343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 11344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 11345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 11346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 11347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 11348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 11349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 11350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 11351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 11352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 11353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 11354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 11355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 11356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 11357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 11358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 11359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 11360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 11361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 11362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 11363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 11364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 11365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 11366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 11367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 11368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 11369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 11370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 11371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 11372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 11373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 11374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 11375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 11376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 11377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 11378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 11379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 11380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 11381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 11382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 11383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 11384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 11385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 11386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 11387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 11388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 11389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 11390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 11391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 11392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 11393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 11394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 11395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 11396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 11397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 11398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 11399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 11400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 11401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 11402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 11403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 11404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 11405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 11406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 11407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 11408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 11409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 11410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 11411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 11412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 11413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 11414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 11415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 11416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 11417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 11418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 11419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 11420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 11421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 11422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 11423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 11424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 11425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 11426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 11427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 11428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 11429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 11430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 11431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 11432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 11433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 11434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 11435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 11436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 11437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 11438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 11439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 11440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 11441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 11442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 11443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 11444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 11445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 11446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 11447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 11448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 11449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 11450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 11451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 11452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 11453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 11454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 11455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 11456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 11457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 11458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 11459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 11460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 11461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 11462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 11463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 11464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 11465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 11466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 11467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 11468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 11469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 11470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 11471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 11472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 11473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 11474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 11475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 11476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 11477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 11478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 11479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 11480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 11481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 11482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 11483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 11484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 11485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 11486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 11487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 11488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 11489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 11490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 11491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 11492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 11493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 11494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 11495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 11496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 11497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 11498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 11499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 11500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 11501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 11502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 11503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 11504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 11505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 11506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 11507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 11508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 11509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 11510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 11511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 11512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 11513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 11514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 11515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 11516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 11517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 11518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 11519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 11520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 11521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 11522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 11523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 11524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 11525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 11526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 11527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 11528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 11529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 11530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 11531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 11532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 11533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 11534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 11535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 11536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 11537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 11538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 11539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 11540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 11541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 11542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 11543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 11544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 11545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 11546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 11547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 11548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 11549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 11550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 11551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 11552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 11553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 11554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 11555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 11556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 11557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 11558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 11559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 11560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 11561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 11562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 11563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 11564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 11565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 11566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 11567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 11568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 11569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 11570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 11571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 11572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 11573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 11574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 11575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 11576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 11577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 11578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 11579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 11580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 11581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 11582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 11583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 11584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 11585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 11586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 11587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 11588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 11589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 11590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 11591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 11592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 11593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 11594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 11595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 11596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 11597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 11598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 11599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 11600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 11601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 11602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 11603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 11604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 11605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 11606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 11607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 11608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 11609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 11610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 11611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 11612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 11613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 11614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 11615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 11616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 11617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 11618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 11619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 11620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 11621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 11622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 11623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 11624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 11625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 11626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 11627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 11628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 11629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 11630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 11631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 11632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 11633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 11634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 11635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 11636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 11637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 11638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 11639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 11640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 11641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 11642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 11643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 11644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 11645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 11646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 11647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 11648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 11649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 11650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 11651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 11652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 11653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 11654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 11655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 11656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 11657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 11658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 11659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 11660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 11661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 11662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 11663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 11664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 11665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 11666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 11667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 11668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 11669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 11670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 11671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 11672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 11673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 11674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 11675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 11676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 11677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 11678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 11679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 11680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 11681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 11682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 11683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 11684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 11685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 11686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 11687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 11688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 11689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 11690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 11691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 11692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 11693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 11694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 11695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 11696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 11697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 11698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 11699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 11700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 11701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 11702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 11703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 11704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 11705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 11706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 11707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 11708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 11709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 11710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 11711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 11712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 11713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 11714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 11715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 11716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 11717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 11718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 11719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 11720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 11721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 11722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 11723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 11724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 11725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 11726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 11727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 11728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 11729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 11730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 11731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 11732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 11733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 11734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 11735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 11736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 11737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 11738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 11739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 11740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 11741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 11742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 11743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 11744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 11745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 11746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 11747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 11748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 11749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 11750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 11751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 11752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 11753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 11754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 11755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 11756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 11757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 11758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 11759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 11760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 11761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 11762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 11763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 11764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 11765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 11766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 11767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 11768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 11769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 11770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 11771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 11772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 11773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 11774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 11775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 11776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 11777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 11778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 11779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 11780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 11781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 11782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 11783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 11784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 11785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 11786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 11787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 11788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 11789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 11790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 11791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 11792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 11793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 11794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 11795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 11796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 11797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 11798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 11799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 11800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 11801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 11802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 11803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 11804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 11805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 11806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 11807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 11808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 11809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 11810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 11811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 11812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 11813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 11814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 11815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 11816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 11817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 11818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 11819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 11820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 11821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 11822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 11823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 11824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 11825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 11826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 11827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 11828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 11829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 11830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 11831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 11832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 11833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 11834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 11835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 11836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 11837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 11838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 11839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 11840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 11841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 11842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 11843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 11844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 11845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 11846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 11847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 11848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 11849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 11850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 11851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 11852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 11853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 11854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 11855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 11856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 11857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 11858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 11859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 11860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 11861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 11862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 11863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 11864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 11865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 11866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 11867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 11868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 11869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 11870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 11871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 11872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 11873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 11874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 11875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 11876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 11877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 11878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 11879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 11880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 11881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 11882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 11883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 11884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 11885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 11886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 11887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 11888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 11889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 11890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 11891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 11892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 11893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 11894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 11895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 11896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 11897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 11898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 11899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 11900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 11901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 11902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 11903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 11904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 11905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 11906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 11907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 11908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 11909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 11910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 11911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 11912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 11913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 11914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 11915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 11916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 11917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 11918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 11919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 11920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 11921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 11922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 11923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 11924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 11925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 11926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 11927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 11928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 11929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 11930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 11931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 11932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 11933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 11934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 11935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 11936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 11937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 11938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 11939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 11940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 11941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 11942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 11943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 11944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 11945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 11946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 11947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 11948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 11949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 11950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 11951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 11952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 11953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 11954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 11955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 11956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 11957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 11958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 11959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 11960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 11961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 11962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 11963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 11964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 11965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 11966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 11967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 11968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 11969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 11970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 11971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 11972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 11973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 11974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 11975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 11976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 11977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 11978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 11979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 11980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 11981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 11982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 11983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 11984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 11985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 11986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 11987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 11988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 11989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 11990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 11991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 11992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 11993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 11994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 11995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 11996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 11997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 11998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 11999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 12000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 12001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 12002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 12003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 12004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 12005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 12006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 12007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 12008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 12009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 12010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 12011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 12012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 12013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 12014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 12015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 12016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 12017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 12018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 12019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 12020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 12021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 12022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 12023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 12024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 12025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 12026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 12027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 12028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 12029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 12030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 12031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 12032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 12033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 12034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 12035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 12036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 12037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 12038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 12039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 12040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 12041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 12042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 12043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 12044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 12045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 12046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 12047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 12048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 12049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 12050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 12051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 12052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 12053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 12054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 12055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 12056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 12057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 12058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 12059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 12060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 12061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 12062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 12063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 12064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 12065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 12066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 12067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 12068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 12069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 12070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 12071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 12072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 12073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 12074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 12075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 12076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 12077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 12078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 12079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 12080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 12081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 12082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 12083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 12084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 12085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 12086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 12087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 12088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 12089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 12090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 12091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 12092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 12093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 12094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 12095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 12096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 12097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 12098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 12099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 12100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 12101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 12102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 12103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 12104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 12105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 12106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 12107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 12108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 12109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 12110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 12111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 12112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 12113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 12114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 12115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 12116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 12117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 12118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 12119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 12120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 12121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 12122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 12123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 12124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 12125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 12126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 12127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 12128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 12129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 12130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 12131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 12132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 12133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 12134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 12135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 12136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 12137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 12138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 12139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 12140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 12141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 12142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 12143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 12144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 12145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 12146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 12147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 12148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 12149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 12150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 12151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 12152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 12153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 12154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 12155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 12156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 12157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 12158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 12159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 12160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 12161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 12162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 12163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 12164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 12165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 12166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 12167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 12168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 12169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 12170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 12171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 12172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 12173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 12174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 12175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 12176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 12177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 12178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 12179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 12180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 12181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 12182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 12183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 12184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 12185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 12186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 12187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 12188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 12189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 12190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 12191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 12192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 12193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 12194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 12195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 12196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 12197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 12198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 12199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 12200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 12201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 12202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 12203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 12204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 12205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 12206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 12207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 12208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 12209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 12210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 12211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 12212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 12213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 12214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 12215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 12216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 12217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 12218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 12219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 12220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 12221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 12222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 12223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 12224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 12225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 12226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 12227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 12228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 12229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 12230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 12231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 12232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 12233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 12234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 12235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 12236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 12237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 12238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 12239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 12240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 12241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 12242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 12243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 12244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 12245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 12246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 12247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 12248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 12249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 12250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 12251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 12252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 12253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 12254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 12255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 12256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 12257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 12258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 12259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 12260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 12261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 12262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 12263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 12264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 12265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 12266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 12267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 12268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 12269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 12270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 12271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 12272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 12273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 12274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 12275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 12276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 12277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 12278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 12279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 12280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 12281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 12282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 12283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 12284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 12285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 12286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 12287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 12288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 12289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 12290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 12291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 12292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 12293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 12294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 12295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 12296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 12297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 12298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 12299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 12300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 12301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 12302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 12303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 12304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 12305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 12306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 12307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 12308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 12309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 12310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 12311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 12312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 12313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 12314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 12315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 12316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 12317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 12318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 12319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 12320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 12321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 12322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 12323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 12324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 12325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 12326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 12327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 12328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 12329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 12330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 12331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 12332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 12333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 12334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 12335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 12336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 12337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 12338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 12339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 12340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 12341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 12342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 12343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 12344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 12345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 12346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 12347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 12348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 12349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 12350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 12351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 12352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 12353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 12354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 12355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 12356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 12357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 12358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 12359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 12360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 12361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 12362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 12363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 12364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 12365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 12366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 12367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 12368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 12369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 12370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 12371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 12372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 12373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 12374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 12375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 12376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 12377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 12378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 12379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 12380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 12381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 12382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 12383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 12384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 12385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 12386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 12387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 12388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 12389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 12390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 12391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 12392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 12393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 12394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 12395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 12396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 12397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 12398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 12399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 12400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 12401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 12402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 12403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 12404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 12405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 12406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 12407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 12408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 12409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 12410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 12411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 12412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 12413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 12414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 12415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 12416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 12417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 12418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 12419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 12420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 12421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 12422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 12423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 12424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 12425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 12426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 12427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 12428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 12429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 12430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 12431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 12432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 12433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 12434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 12435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 12436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 12437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 12438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 12439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 12440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 12441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 12442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 12443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 12444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 12445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 12446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 12447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 12448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 12449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 12450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 12451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 12452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 12453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 12454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 12455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 12456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 12457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 12458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 12459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 12460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 12461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 12462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 12463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 12464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 12465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 12466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 12467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 12468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 12469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 12470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 12471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 12472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 12473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 12474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 12475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 12476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 12477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 12478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 12479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 12480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 12481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 12482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 12483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 12484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 12485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 12486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 12487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 12488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 12489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 12490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 12491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 12492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 12493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 12494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 12495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 12496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 12497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 12498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 12499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 12500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 12501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 12502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 12503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 12504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 12505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 12506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 12507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 12508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 12509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 12510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 12511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 12512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 12513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 12514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 12515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 12516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 12517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 12518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 12519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 12520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 12521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 12522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 12523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 12524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 12525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 12526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 12527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 12528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 12529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 12530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 12531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 12532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 12533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 12534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 12535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 12536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 12537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 12538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 12539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 12540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 12541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 12542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 12543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 12544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 12545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 12546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 12547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 12548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 12549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 12550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 12551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 12552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 12553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 12554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 12555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 12556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 12557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 12558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 12559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 12560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 12561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 12562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 12563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 12564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 12565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 12566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 12567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 12568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 12569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 12570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 12571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 12572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 12573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 12574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 12575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 12576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 12577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 12578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 12579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 12580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 12581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 12582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 12583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 12584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 12585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 12586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 12587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 12588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 12589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 12590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 12591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 12592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 12593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 12594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 12595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 12596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 12597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 12598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 12599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 12600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 12601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 12602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 12603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 12604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 12605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 12606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 12607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 12608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 12609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 12610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 12611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 12612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 12613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 12614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 12615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 12616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 12617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 12618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 12619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 12620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 12621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 12622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 12623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 12624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 12625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 12626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 12627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 12628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 12629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 12630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 12631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 12632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 12633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 12634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 12635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 12636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 12637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 12638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 12639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 12640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 12641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 12642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 12643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 12644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 12645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 12646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 12647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 12648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 12649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 12650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 12651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 12652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 12653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 12654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 12655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 12656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 12657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 12658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 12659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 12660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 12661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 12662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 12663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 12664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 12665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 12666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 12667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 12668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 12669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 12670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 12671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 12672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 12673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 12674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 12675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 12676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 12677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 12678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 12679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 12680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 12681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 12682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 12683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 12684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 12685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 12686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 12687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 12688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 12689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 12690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 12691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 12692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 12693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 12694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 12695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 12696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 12697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 12698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 12699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 12700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 12701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 12702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 12703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 12704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 12705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 12706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 12707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 12708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 12709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 12710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 12711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 12712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 12713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 12714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 12715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 12716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 12717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 12718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 12719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 12720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 12721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 12722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 12723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 12724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 12725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 12726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 12727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 12728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 12729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 12730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 12731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 12732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 12733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 12734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 12735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 12736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 12737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 12738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 12739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 12740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 12741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 12742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 12743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 12744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 12745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 12746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 12747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 12748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 12749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 12750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 12751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 12752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 12753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 12754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 12755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 12756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 12757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 12758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 12759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 12760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 12761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 12762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 12763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 12764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 12765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 12766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 12767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 12768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 12769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 12770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 12771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 12772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 12773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 12774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 12775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 12776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 12777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 12778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 12779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 12780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 12781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 12782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 12783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 12784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 12785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 12786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 12787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 12788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 12789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 12790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 12791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 12792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 12793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 12794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 12795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 12796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 12797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 12798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 12799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 12800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 12801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 12802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 12803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 12804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 12805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 12806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 12807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 12808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 12809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 12810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 12811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 12812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 12813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 12814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 12815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 12816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 12817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 12818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 12819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 12820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 12821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 12822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 12823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 12824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 12825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 12826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 12827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 12828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 12829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 12830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 12831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 12832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 12833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 12834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 12835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 12836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 12837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 12838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 12839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 12840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 12841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 12842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 12843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 12844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 12845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 12846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 12847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 12848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 12849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 12850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 12851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 12852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 12853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 12854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 12855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 12856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 12857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 12858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 12859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 12860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 12861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 12862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 12863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 12864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 12865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 12866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 12867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 12868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 12869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 12870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 12871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 12872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 12873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 12874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 12875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 12876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 12877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 12878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 12879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 12880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 12881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 12882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 12883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 12884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 12885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 12886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 12887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 12888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 12889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 12890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 12891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 12892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 12893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 12894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 12895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 12896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 12897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 12898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 12899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 12900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 12901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 12902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 12903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 12904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 12905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 12906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 12907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 12908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 12909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 12910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 12911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 12912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 12913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 12914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 12915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 12916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 12917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 12918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 12919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 12920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 12921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 12922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 12923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 12924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 12925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 12926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 12927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 12928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 12929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 12930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 12931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 12932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 12933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 12934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 12935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 12936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 12937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 12938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 12939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 12940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 12941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 12942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 12943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 12944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 12945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 12946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 12947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 12948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 12949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 12950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 12951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 12952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 12953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 12954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 12955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 12956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 12957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 12958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 12959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 12960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 12961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 12962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 12963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 12964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 12965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 12966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 12967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 12968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 12969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 12970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 12971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 12972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 12973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 12974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 12975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 12976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 12977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 12978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 12979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 12980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 12981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 12982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 12983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 12984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 12985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 12986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 12987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 12988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 12989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 12990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 12991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 12992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 12993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 12994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 12995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 12996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 12997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 12998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 12999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 13000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 13001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 13002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 13003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 13004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 13005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 13006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 13007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 13008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 13009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 13010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 13011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 13012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 13013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 13014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 13015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 13016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 13017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 13018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 13019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 13020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 13021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 13022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 13023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 13024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 13025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 13026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 13027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 13028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 13029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 13030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 13031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 13032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 13033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 13034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 13035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 13036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 13037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 13038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 13039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 13040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 13041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 13042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 13043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 13044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 13045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 13046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 13047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 13048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 13049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 13050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 13051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 13052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 13053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 13054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 13055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 13056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 13057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 13058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 13059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 13060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 13061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 13062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 13063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 13064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 13065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 13066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 13067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 13068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 13069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 13070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 13071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 13072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 13073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 13074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 13075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 13076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 13077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 13078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 13079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 13080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 13081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 13082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 13083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 13084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 13085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 13086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 13087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 13088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 13089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 13090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 13091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 13092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 13093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 13094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 13095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 13096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 13097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 13098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 13099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 13100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 13101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 13102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 13103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 13104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 13105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 13106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 13107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 13108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 13109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 13110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 13111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 13112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 13113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 13114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 13115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 13116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 13117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 13118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 13119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 13120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 13121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 13122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 13123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 13124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 13125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 13126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 13127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 13128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 13129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 13130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 13131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 13132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 13133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 13134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 13135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 13136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 13137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 13138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 13139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 13140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 13141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 13142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 13143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 13144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 13145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 13146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 13147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 13148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 13149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 13150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 13151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 13152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 13153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 13154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 13155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 13156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 13157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 13158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 13159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 13160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 13161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 13162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 13163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 13164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 13165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 13166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 13167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 13168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 13169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 13170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 13171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 13172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 13173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 13174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 13175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 13176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 13177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 13178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 13179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 13180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 13181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 13182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 13183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 13184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 13185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 13186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 13187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 13188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 13189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 13190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 13191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 13192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 13193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 13194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 13195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 13196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 13197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 13198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 13199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 13200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 13201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 13202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 13203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 13204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 13205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 13206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 13207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 13208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 13209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 13210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 13211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 13212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 13213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 13214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 13215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 13216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 13217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 13218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 13219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 13220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 13221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 13222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 13223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 13224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 13225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 13226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 13227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 13228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 13229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 13230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 13231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 13232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 13233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 13234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 13235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 13236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 13237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 13238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 13239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 13240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 13241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 13242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 13243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 13244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 13245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 13246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 13247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 13248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 13249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 13250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 13251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 13252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 13253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 13254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 13255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 13256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 13257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 13258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 13259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 13260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 13261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 13262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 13263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 13264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 13265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 13266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 13267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 13268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 13269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 13270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 13271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 13272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 13273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 13274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 13275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 13276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 13277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 13278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 13279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 13280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 13281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 13282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 13283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 13284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 13285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 13286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 13287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 13288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 13289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 13290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 13291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 13292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 13293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 13294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 13295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 13296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 13297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 13298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 13299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 13300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 13301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 13302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 13303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 13304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 13305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 13306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 13307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 13308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 13309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 13310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 13311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 13312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 13313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 13314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 13315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 13316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 13317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 13318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 13319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 13320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 13321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 13322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 13323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 13324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 13325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 13326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 13327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 13328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 13329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 13330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 13331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 13332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 13333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 13334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 13335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 13336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 13337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 13338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 13339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 13340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 13341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 13342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 13343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 13344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 13345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 13346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 13347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 13348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 13349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 13350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 13351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 13352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 13353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 13354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 13355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 13356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 13357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 13358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 13359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 13360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 13361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 13362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 13363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 13364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 13365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 13366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 13367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 13368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 13369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 13370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 13371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 13372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 13373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 13374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 13375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 13376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 13377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 13378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 13379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 13380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 13381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 13382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 13383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 13384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 13385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 13386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 13387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 13388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 13389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 13390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 13391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 13392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 13393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 13394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 13395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 13396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 13397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 13398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 13399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 13400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 13401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 13402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 13403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 13404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 13405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 13406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 13407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 13408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 13409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 13410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 13411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 13412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 13413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 13414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 13415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 13416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 13417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 13418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 13419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 13420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 13421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 13422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 13423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 13424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 13425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 13426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 13427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 13428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 13429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 13430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 13431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 13432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 13433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 13434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 13435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 13436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 13437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 13438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 13439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 13440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 13441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 13442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 13443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 13444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 13445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 13446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 13447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 13448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 13449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 13450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 13451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 13452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 13453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 13454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 13455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 13456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 13457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 13458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 13459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 13460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 13461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 13462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 13463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 13464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 13465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 13466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 13467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 13468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 13469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 13470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 13471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 13472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 13473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 13474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 13475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 13476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 13477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 13478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 13479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 13480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 13481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 13482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 13483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 13484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 13485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 13486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 13487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 13488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 13489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 13490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 13491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 13492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 13493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 13494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 13495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 13496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 13497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 13498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 13499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 13500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 13501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 13502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 13503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 13504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 13505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 13506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 13507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 13508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 13509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 13510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 13511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 13512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 13513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 13514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 13515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 13516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 13517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 13518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 13519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 13520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 13521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 13522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 13523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 13524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 13525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 13526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 13527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHDHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 13528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 13529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 13530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 13531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 13532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 13533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 13534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 13535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 13536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 13537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 13538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 13539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 13540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 13541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 13542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 13543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 13544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 13545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 13546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 13547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 13548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 13549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 13550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 13551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 13552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 13553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 13554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 13555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 13556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 13557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 13558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 13559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 13560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 13561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 13562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 13563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 13564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 13565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 13566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 13567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 13568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 13569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 13570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 13571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 13572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 13573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 13574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 13575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 13576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 13577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 13578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 13579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 13580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 13581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 13582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 13583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 13584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 13585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 13586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 13587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 13588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 13589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 13590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 13591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 13592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 13593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 13594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 13595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 13596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 13597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 13598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 13599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 13600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 13601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 13602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 13603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 13604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 13605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 13606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 13607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 13608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 13609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 13610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 13611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 13612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 13613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 13614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 13615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 13616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 13617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 13618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 13619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 13620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 13621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 13622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 13623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 13624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 13625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 13626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 13627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 13628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 13629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 13630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 13631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 13632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 13633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 13634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 13635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 13636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 13637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 13638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 13639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 13640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 13641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 13642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 13643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 13644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 13645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 13646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 13647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 13648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 13649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 13650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 13651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 13652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 13653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 13654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 13655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 13656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 13657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 13658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 13659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 13660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 13661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 13662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 13663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 13664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 13665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 13666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 13667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 13668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 13669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 13670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 13671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 13672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 13673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 13674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 13675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 13676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 13677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 13678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 13679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 13680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 13681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 13682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 13683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 13684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 13685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 13686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 13687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 13688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 13689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 13690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 13691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 13692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 13693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 13694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 13695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 13696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 13697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 13698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 13699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 13700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 13701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 13702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 13703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 13704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 13705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 13706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 13707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 13708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 13709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 13710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 13711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 13712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 13713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 13714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 13715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 13716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 13717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 13718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 13719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 13720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 13721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 13722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 13723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 13724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 13725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 13726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 13727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 13728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 13729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 13730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 13731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 13732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 13733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 13734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 13735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 13736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 13737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 13738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 13739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 13740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 13741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 13742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 13743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 13744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 13745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 13746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 13747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 13748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 13749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 13750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 13751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 13752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 13753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 13754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 13755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 13756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 13757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 13758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 13759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 13760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 13761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 13762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 13763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 13764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 13765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 13766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 13767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 13768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 13769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 13770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 13771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 13772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 13773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 13774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 13775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 13776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 13777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 13778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 13779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 13780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 13781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 13782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 13783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 13784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 13785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 13786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 13787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 13788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 13789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 13790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 13791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 13792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 13793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 13794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 13795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 13796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 13797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 13798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 13799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 13800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 13801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 13802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 13803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 13804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 13805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 13806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 13807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 13808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 13809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 13810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 13811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 13812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 13813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 13814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 13815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 13816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 13817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 13818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 13819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 13820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 13821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 13822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 13823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 13824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 13825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 13826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 13827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 13828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 13829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 13830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 13831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 13832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 13833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 13834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 13835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 13836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 13837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 13838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 13839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 13840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 13841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 13842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 13843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 13844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 13845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 13846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 13847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 13848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 13849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 13850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 13851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 13852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 13853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 13854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 13855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 13856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 13857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 13858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 13859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 13860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 13861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 13862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 13863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 13864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 13865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 13866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 13867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 13868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 13869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 13870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 13871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 13872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 13873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 13874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 13875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 13876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 13877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 13878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 13879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 13880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 13881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 13882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 13883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 13884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 13885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 13886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 13887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 13888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 13889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 13890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 13891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 13892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 13893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 13894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 13895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 13896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 13897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 13898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 13899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 13900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 13901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 13902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 13903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 13904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 13905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 13906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 13907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 13908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 13909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 13910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 13911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 13912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 13913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 13914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 13915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 13916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 13917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 13918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 13919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 13920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 13921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 13922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 13923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 13924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 13925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 13926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 13927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 13928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 13929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 13930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 13931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 13932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 13933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 13934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 13935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 13936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 13937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 13938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 13939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 13940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 13941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 13942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 13943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 13944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 13945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 13946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 13947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 13948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 13949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 13950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 13951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 13952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 13953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 13954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 13955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 13956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 13957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 13958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 13959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 13960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 13961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 13962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 13963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 13964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 13965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 13966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 13967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 13968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 13969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 13970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 13971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 13972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 13973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 13974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 13975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 13976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 13977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 13978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 13979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 13980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 13981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 13982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 13983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 13984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 13985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 13986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 13987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 13988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 13989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 13990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 13991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 13992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 13993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 13994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 13995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 13996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 13997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 13998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 13999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 14000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 14001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 14002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 14003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 14004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 14005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 14006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 14007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 14008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 14009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 14010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 14011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 14012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 14013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 14014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 14015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 14016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 14017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 14018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 14019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 14020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 14021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 14022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 14023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 14024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 14025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 14026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 14027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 14028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 14029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 14030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 14031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 14032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 14033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 14034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 14035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 14036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 14037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 14038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 14039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 14040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 14041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 14042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 14043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 14044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 14045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 14046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 14047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 14048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 14049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 14050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 14051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 14052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 14053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 14054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 14055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 14056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 14057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 14058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 14059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 14060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 14061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 14062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 14063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 14064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 14065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 14066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 14067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 14068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 14069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 14070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 14071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 14072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 14073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 14074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 14075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 14076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 14077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 14078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 14079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 14080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 14081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 14082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 14083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 14084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 14085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 14086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 14087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 14088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 14089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 14090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 14091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 14092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 14093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 14094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 14095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 14096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 14097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 14098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 14099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 14100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 14101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 14102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 14103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 14104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 14105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 14106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 14107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 14108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 14109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 14110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 14111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 14112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 14113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 14114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 14115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 14116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 14117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 14118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 14119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 14120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 14121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 14122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 14123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 14124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 14125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 14126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 14127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 14128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 14129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 14130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 14131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 14132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 14133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 14134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 14135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 14136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 14137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 14138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 14139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 14140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 14141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 14142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 14143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 14144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 14145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 14146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 14147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 14148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 14149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 14150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 14151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 14152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 14153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 14154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 14155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 14156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 14157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 14158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 14159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 14160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 14161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 14162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 14163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 14164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 14165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 14166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 14167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 14168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 14169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 14170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 14171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 14172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 14173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 14174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 14175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 14176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 14177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 14178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 14179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 14180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 14181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 14182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 14183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 14184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 14185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 14186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 14187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 14188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 14189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 14190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 14191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 14192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 14193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 14194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 14195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 14196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 14197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 14198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 14199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 14200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 14201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 14202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 14203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 14204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 14205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 14206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 14207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 14208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 14209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 14210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 14211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 14212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 14213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 14214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 14215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 14216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 14217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 14218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 14219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 14220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 14221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 14222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 14223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 14224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 14225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 14226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 14227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 14228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 14229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 14230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 14231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 14232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 14233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 14234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 14235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 14236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 14237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 14238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 14239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 14240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 14241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 14242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 14243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 14244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 14245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 14246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 14247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 14248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 14249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 14250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 14251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 14252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 14253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 14254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 14255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 14256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 14257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 14258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 14259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 14260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 14261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 14262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 14263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 14264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 14265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 14266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 14267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 14268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 14269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 14270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 14271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 14272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 14273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 14274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 14275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 14276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 14277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 14278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 14279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 14280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 14281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 14282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 14283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 14284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 14285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 14286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 14287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 14288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 14289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 14290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 14291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 14292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 14293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 14294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 14295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 14296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 14297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 14298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 14299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 14300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 14301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 14302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 14303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 14304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 14305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 14306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 14307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 14308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 14309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 14310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 14311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 14312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 14313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 14314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 14315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 14316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 14317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 14318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 14319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 14320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 14321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 14322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 14323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 14324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 14325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 14326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 14327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 14328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 14329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 14330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 14331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 14332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 14333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 14334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 14335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 14336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 14337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 14338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 14339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 14340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 14341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 14342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 14343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 14344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 14345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 14346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 14347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 14348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 14349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 14350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 14351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 14352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 14353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 14354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 14355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 14356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 14357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 14358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 14359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 14360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 14361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 14362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 14363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 14364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 14365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 14366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 14367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 14368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 14369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 14370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 14371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 14372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 14373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 14374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 14375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 14376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 14377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 14378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 14379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 14380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 14381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 14382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 14383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 14384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 14385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 14386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 14387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 14388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 14389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 14390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 14391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 14392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 14393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 14394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 14395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 14396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 14397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 14398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 14399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 14400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 14401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 14402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 14403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 14404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 14405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 14406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 14407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 14408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 14409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 14410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 14411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 14412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 14413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 14414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 14415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 14416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 14417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 14418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 14419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 14420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 14421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 14422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 14423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 14424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 14425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 14426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 14427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 14428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 14429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 14430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 14431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 14432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 14433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 14434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 14435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 14436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 14437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 14438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 14439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 14440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 14441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 14442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 14443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 14444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 14445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 14446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 14447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 14448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 14449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 14450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 14451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 14452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 14453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 14454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 14455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 14456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 14457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 14458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 14459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 14460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 14461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 14462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 14463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 14464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 14465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 14466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 14467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 14468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 14469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 14470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 14471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 14472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 14473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 14474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 14475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 14476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 14477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 14478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 14479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 14480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 14481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 14482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 14483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 14484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 14485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 14486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 14487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 14488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 14489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 14490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 14491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 14492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 14493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 14494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 14495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 14496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 14497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 14498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 14499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 14500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 14501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 14502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 14503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 14504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 14505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 14506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 14507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 14508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 14509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 14510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 14511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 14512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 14513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 14514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 14515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 14516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 14517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 14518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 14519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 14520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 14521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 14522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 14523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 14524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 14525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 14526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 14527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 14528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 14529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 14530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 14531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 14532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 14533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 14534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 14535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 14536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 14537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 14538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 14539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 14540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 14541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 14542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 14543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 14544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 14545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 14546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 14547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 14548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 14549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 14550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 14551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 14552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 14553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 14554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 14555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 14556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 14557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 14558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 14559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 14560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 14561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 14562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 14563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 14564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 14565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 14566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 14567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 14568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 14569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 14570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 14571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 14572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 14573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 14574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 14575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 14576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 14577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 14578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 14579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 14580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 14581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 14582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 14583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 14584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 14585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 14586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 14587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 14588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 14589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 14590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 14591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 14592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 14593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 14594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 14595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 14596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 14597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 14598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 14599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 14600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 14601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 14602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 14603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 14604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 14605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 14606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 14607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 14608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 14609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 14610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 14611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 14612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 14613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 14614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 14615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 14616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 14617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 14618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 14619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 14620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 14621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 14622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 14623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 14624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 14625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 14626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 14627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 14628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 14629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 14630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 14631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 14632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 14633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 14634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 14635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 14636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 14637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 14638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 14639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 14640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 14641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 14642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 14643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 14644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 14645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 14646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 14647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 14648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 14649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 14650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 14651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 14652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 14653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 14654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 14655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 14656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 14657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 14658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 14659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 14660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 14661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 14662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 14663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 14664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 14665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 14666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 14667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 14668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 14669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 14670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 14671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 14672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 14673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 14674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 14675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 14676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 14677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 14678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 14679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 14680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 14681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 14682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 14683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 14684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 14685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 14686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 14687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 14688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 14689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 14690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 14691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 14692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 14693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 14694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 14695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 14696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 14697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 14698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 14699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 14700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 14701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 14702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 14703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 14704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 14705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 14706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 14707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 14708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 14709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 14710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 14711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 14712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 14713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 14714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 14715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 14716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 14717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 14718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 14719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 14720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 14721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 14722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 14723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 14724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 14725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 14726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 14727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 14728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 14729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 14730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 14731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 14732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 14733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 14734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 14735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 14736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 14737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 14738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 14739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 14740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 14741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 14742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 14743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 14744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 14745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 14746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 14747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 14748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 14749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 14750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 14751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 14752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 14753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 14754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 14755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 14756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 14757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 14758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 14759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 14760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 14761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 14762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 14763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 14764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 14765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 14766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 14767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 14768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 14769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 14770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 14771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 14772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 14773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 14774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 14775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 14776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 14777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 14778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 14779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 14780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 14781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 14782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 14783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 14784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 14785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 14786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 14787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 14788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 14789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 14790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 14791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 14792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 14793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 14794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 14795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 14796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 14797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 14798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 14799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 14800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 14801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 14802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 14803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 14804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 14805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 14806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 14807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 14808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 14809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 14810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 14811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 14812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 14813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 14814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 14815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 14816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 14817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 14818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 14819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 14820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 14821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 14822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 14823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 14824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 14825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 14826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 14827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 14828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 14829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 14830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 14831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 14832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 14833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 14834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 14835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 14836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 14837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 14838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 14839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 14840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 14841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 14842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 14843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 14844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 14845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 14846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 14847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 14848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 14849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 14850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 14851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 14852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 14853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 14854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 14855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 14856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 14857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 14858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 14859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 14860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 14861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 14862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 14863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 14864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 14865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 14866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 14867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 14868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 14869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 14870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 14871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 14872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 14873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 14874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 14875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 14876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 14877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 14878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 14879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 14880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 14881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 14882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 14883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 14884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 14885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 14886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 14887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 14888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 14889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 14890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 14891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 14892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 14893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 14894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 14895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 14896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 14897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 14898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 14899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 14900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 14901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 14902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 14903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 14904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 14905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 14906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 14907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 14908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 14909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 14910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 14911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 14912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 14913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 14914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 14915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 14916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 14917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 14918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 14919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 14920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 14921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 14922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 14923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 14924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 14925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 14926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 14927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 14928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 14929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 14930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 14931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 14932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 14933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 14934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 14935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 14936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 14937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 14938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 14939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 14940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 14941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 14942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 14943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 14944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 14945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 14946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 14947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 14948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 14949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 14950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 14951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 14952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 14953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 14954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 14955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 14956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 14957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 14958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 14959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 14960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 14961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 14962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 14963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 14964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 14965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 14966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 14967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 14968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 14969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 14970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 14971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 14972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 14973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 14974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 14975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 14976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 14977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 14978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 14979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 14980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 14981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 14982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 14983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 14984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 14985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 14986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 14987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 14988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 14989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 14990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 14991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 14992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 14993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 14994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 14995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 14996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 14997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 14998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 14999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 15000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 15001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 15002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 15003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 15004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 15005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 15006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 15007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 15008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 15009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 15010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 15011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 15012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 15013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 15014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 15015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 15016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 15017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 15018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 15019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 15020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 15021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 15022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 15023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 15024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 15025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 15026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 15027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 15028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 15029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 15030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 15031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 15032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 15033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 15034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 15035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 15036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 15037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 15038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 15039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 15040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 15041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 15042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 15043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 15044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 15045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 15046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 15047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 15048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 15049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 15050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 15051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 15052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 15053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 15054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 15055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 15056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 15057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 15058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 15059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 15060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 15061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 15062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 15063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 15064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 15065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 15066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 15067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 15068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 15069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 15070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 15071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 15072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 15073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 15074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 15075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 15076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 15077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 15078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 15079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 15080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 15081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 15082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 15083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 15084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 15085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 15086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 15087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 15088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 15089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 15090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 15091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 15092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 15093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 15094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 15095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 15096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 15097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 15098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 15099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 15100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 15101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 15102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 15103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 15104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 15105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 15106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 15107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 15108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 15109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 15110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 15111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 15112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 15113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 15114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 15115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 15116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 15117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 15118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 15119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 15120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 15121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 15122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 15123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 15124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 15125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 15126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 15127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 15128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 15129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 15130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 15131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 15132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 15133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 15134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 15135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 15136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 15137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 15138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 15139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 15140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 15141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 15142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 15143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 15144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 15145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 15146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 15147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 15148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 15149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 15150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 15151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 15152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 15153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 15154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 15155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 15156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 15157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 15158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 15159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 15160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 15161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 15162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 15163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 15164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 15165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 15166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 15167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 15168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 15169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 15170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 15171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 15172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 15173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 15174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 15175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 15176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 15177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 15178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 15179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 15180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 15181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 15182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 15183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 15184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 15185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 15186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 15187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 15188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 15189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 15190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 15191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 15192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 15193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 15194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 15195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 15196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 15197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 15198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 15199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 15200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 15201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 15202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 15203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 15204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 15205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 15206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 15207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 15208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 15209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 15210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 15211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 15212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 15213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 15214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 15215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 15216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 15217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 15218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 15219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 15220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 15221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 15222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 15223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 15224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 15225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 15226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 15227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 15228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 15229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 15230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 15231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 15232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 15233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 15234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 15235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 15236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 15237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 15238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 15239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 15240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 15241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 15242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 15243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 15244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 15245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 15246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 15247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 15248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 15249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 15250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 15251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 15252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 15253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 15254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 15255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 15256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 15257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 15258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 15259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 15260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 15261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 15262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 15263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 15264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 15265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 15266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 15267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 15268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 15269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 15270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 15271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 15272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 15273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 15274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 15275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 15276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 15277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 15278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 15279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 15280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 15281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 15282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 15283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 15284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 15285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 15286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 15287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 15288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 15289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 15290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 15291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 15292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 15293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 15294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 15295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 15296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 15297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 15298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 15299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 15300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 15301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 15302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 15303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 15304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 15305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 15306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 15307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 15308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 15309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 15310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 15311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 15312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 15313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 15314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 15315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 15316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 15317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 15318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 15319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 15320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 15321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 15322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 15323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 15324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 15325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 15326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 15327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 15328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 15329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 15330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 15331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 15332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 15333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 15334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 15335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 15336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 15337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 15338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 15339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 15340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 15341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 15342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 15343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 15344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 15345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 15346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 15347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 15348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 15349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 15350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 15351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 15352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 15353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 15354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 15355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 15356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 15357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 15358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 15359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 15360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 15361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 15362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 15363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 15364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 15365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 15366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 15367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 15368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 15369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 15370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 15371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 15372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 15373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 15374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 15375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 15376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 15377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 15378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 15379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 15380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 15381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 15382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 15383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 15384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 15385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 15386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 15387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 15388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 15389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 15390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 15391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 15392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 15393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 15394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 15395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 15396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 15397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 15398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 15399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 15400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 15401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 15402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 15403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 15404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 15405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 15406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 15407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 15408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 15409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 15410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 15411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 15412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 15413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 15414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 15415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 15416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 15417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 15418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 15419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 15420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 15421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 15422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 15423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 15424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 15425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 15426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 15427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 15428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 15429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 15430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 15431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 15432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 15433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 15434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 15435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 15436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 15437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 15438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 15439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 15440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 15441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 15442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 15443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 15444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 15445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 15446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 15447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 15448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 15449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 15450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 15451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 15452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 15453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 15454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 15455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 15456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 15457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 15458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 15459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 15460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 15461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 15462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 15463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 15464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 15465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 15466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 15467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 15468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 15469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 15470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 15471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 15472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 15473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 15474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 15475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 15476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 15477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 15478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 15479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 15480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 15481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 15482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 15483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 15484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 15485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 15486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 15487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 15488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 15489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 15490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 15491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 15492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 15493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 15494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 15495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 15496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 15497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 15498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 15499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 15500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 15501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 15502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 15503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 15504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 15505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 15506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 15507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 15508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 15509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 15510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 15511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 15512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 15513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 15514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 15515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 15516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 15517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 15518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 15519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 15520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 15521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 15522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 15523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 15524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 15525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 15526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 15527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 15528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 15529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 15530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 15531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 15532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 15533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 15534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 15535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 15536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 15537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 15538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 15539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 15540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 15541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 15542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 15543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 15544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 15545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 15546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 15547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 15548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 15549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 15550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 15551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 15552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 15553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 15554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 15555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 15556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 15557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 15558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 15559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 15560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 15561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 15562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 15563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 15564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 15565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 15566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 15567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 15568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 15569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 15570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 15571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 15572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 15573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 15574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 15575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 15576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 15577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 15578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 15579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 15580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 15581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 15582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 15583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 15584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 15585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 15586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 15587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 15588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 15589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 15590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 15591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 15592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 15593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 15594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 15595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 15596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 15597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 15598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 15599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 15600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 15601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 15602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 15603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 15604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 15605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 15606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 15607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 15608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 15609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 15610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 15611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 15612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 15613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 15614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 15615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 15616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 15617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 15618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 15619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 15620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 15621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 15622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 15623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 15624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 15625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 15626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 15627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 15628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 15629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 15630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 15631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 15632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 15633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 15634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 15635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 15636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 15637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 15638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 15639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 15640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 15641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 15642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 15643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 15644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 15645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 15646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 15647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 15648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 15649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 15650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 15651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 15652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 15653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 15654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 15655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 15656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 15657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 15658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 15659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 15660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 15661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 15662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 15663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 15664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 15665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 15666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 15667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 15668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 15669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 15670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 15671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 15672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 15673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 15674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 15675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 15676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 15677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 15678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 15679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 15680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 15681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 15682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 15683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 15684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 15685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 15686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 15687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 15688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 15689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 15690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 15691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 15692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 15693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 15694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 15695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 15696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 15697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 15698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 15699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 15700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 15701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 15702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 15703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 15704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 15705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 15706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 15707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 15708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 15709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 15710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 15711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 15712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 15713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 15714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 15715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 15716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 15717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 15718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 15719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 15720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 15721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 15722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 15723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 15724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 15725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 15726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 15727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 15728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 15729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 15730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 15731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 15732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 15733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 15734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 15735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 15736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 15737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 15738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 15739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 15740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 15741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 15742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 15743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 15744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 15745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 15746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 15747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 15748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 15749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 15750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 15751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 15752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 15753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 15754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 15755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 15756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 15757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 15758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 15759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 15760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 15761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 15762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 15763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 15764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 15765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 15766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 15767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 15768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 15769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 15770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 15771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 15772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 15773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 15774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 15775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 15776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 15777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 15778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 15779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 15780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 15781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 15782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 15783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 15784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 15785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 15786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 15787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 15788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 15789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 15790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 15791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 15792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 15793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 15794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 15795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 15796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 15797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 15798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 15799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 15800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 15801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 15802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 15803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 15804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 15805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 15806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 15807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 15808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 15809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 15810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 15811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 15812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 15813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 15814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 15815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 15816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 15817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 15818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 15819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 15820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 15821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 15822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 15823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 15824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 15825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 15826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 15827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 15828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 15829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 15830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 15831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 15832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 15833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 15834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 15835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 15836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 15837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 15838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 15839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 15840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 15841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 15842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 15843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 15844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 15845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 15846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 15847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 15848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 15849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 15850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 15851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 15852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 15853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 15854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 15855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 15856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 15857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 15858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 15859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 15860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 15861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 15862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 15863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 15864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 15865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 15866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 15867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 15868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 15869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 15870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 15871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 15872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 15873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 15874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 15875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 15876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 15877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 15878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 15879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 15880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 15881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 15882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 15883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 15884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 15885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 15886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 15887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 15888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 15889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 15890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 15891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 15892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 15893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 15894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 15895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 15896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 15897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 15898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 15899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 15900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 15901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 15902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 15903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 15904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 15905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 15906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 15907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 15908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 15909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 15910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 15911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 15912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 15913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 15914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 15915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 15916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 15917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 15918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 15919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 15920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 15921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 15922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 15923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 15924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 15925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 15926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 15927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 15928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 15929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 15930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 15931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 15932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 15933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 15934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 15935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 15936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 15937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 15938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 15939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 15940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 15941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 15942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 15943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 15944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 15945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 15946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 15947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 15948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 15949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 15950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 15951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 15952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 15953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 15954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 15955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 15956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 15957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 15958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 15959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 15960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 15961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 15962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 15963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 15964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 15965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 15966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 15967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 15968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 15969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 15970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 15971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 15972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 15973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 15974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 15975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 15976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 15977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 15978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 15979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 15980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 15981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 15982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 15983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 15984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 15985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 15986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 15987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 15988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 15989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 15990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 15991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 15992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 15993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 15994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 15995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 15996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 15997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 15998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 15999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 16000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 16001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 16002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 16003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 16004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 16005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 16006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 16007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 16008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 16009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 16010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 16011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 16012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 16013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 16014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 16015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 16016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 16017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 16018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 16019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 16020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 16021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 16022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 16023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 16024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 16025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 16026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 16027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 16028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 16029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 16030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 16031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 16032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 16033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 16034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 16035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 16036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 16037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 16038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 16039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 16040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 16041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 16042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 16043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 16044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 16045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 16046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 16047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 16048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 16049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 16050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 16051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 16052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 16053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 16054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 16055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 16056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 16057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 16058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 16059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 16060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 16061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 16062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 16063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 16064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 16065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 16066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 16067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 16068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 16069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 16070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 16071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 16072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 16073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 16074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 16075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 16076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 16077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 16078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 16079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 16080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 16081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 16082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 16083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 16084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 16085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 16086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 16087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 16088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 16089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 16090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 16091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 16092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 16093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 16094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 16095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 16096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 16097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 16098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 16099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 16100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 16101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 16102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 16103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 16104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 16105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 16106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 16107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 16108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 16109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 16110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 16111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 16112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 16113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 16114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 16115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 16116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 16117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 16118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 16119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 16120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 16121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 16122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 16123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 16124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 16125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 16126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 16127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 16128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 16129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 16130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 16131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 16132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 16133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 16134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 16135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 16136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 16137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 16138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 16139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 16140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 16141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 16142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 16143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 16144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 16145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 16146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 16147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 16148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 16149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 16150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 16151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 16152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 16153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 16154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 16155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 16156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 16157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 16158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 16159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 16160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 16161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 16162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 16163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 16164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 16165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 16166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 16167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 16168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 16169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 16170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 16171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 16172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 16173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 16174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 16175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 16176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 16177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 16178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 16179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 16180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 16181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 16182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 16183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 16184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 16185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 16186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 16187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 16188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 16189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 16190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 16191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 16192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 16193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 16194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 16195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 16196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 16197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 16198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 16199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 16200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 16201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 16202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 16203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 16204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 16205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 16206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 16207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 16208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 16209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 16210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 16211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 16212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 16213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 16214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 16215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 16216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 16217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 16218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 16219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 16220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 16221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 16222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 16223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 16224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 16225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 16226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 16227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHHHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 16228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 16229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 16230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 16231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 16232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 16233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 16234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 16235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 16236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 16237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 16238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 16239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 16240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 16241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 16242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 16243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 16244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 16245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 16246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 16247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 16248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 16249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 16250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 16251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 16252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 16253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 16254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 16255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 16256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 16257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 16258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 16259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 16260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 16261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 16262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 16263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 16264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 16265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 16266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 16267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 16268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 16269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 16270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 16271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 16272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 16273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 16274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 16275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 16276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 16277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 16278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 16279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 16280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 16281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 16282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 16283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 16284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 16285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 16286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 16287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 16288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 16289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 16290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 16291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 16292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 16293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 16294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 16295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 16296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 16297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 16298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 16299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 16300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 16301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 16302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 16303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 16304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 16305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 16306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 16307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 16308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 16309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 16310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 16311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 16312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 16313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 16314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 16315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 16316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 16317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 16318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 16319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 16320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 16321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 16322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 16323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 16324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 16325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 16326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 16327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 16328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 16329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 16330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 16331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 16332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 16333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 16334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 16335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 16336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 16337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 16338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 16339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 16340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 16341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 16342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 16343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 16344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 16345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 16346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 16347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 16348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 16349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 16350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 16351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 16352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 16353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 16354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 16355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 16356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 16357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 16358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 16359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 16360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 16361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 16362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 16363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 16364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 16365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 16366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 16367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 16368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 16369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 16370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 16371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 16372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 16373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 16374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 16375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 16376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 16377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 16378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 16379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 16380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 16381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 16382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 16383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 16384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 16385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 16386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 16387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 16388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 16389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 16390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 16391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 16392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 16393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 16394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 16395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 16396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 16397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 16398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 16399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 16400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 16401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 16402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 16403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 16404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 16405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 16406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 16407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 16408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 16409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 16410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 16411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 16412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 16413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 16414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 16415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 16416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 16417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 16418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 16419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 16420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 16421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 16422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 16423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 16424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 16425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 16426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 16427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 16428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 16429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 16430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 16431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 16432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 16433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 16434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 16435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 16436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 16437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 16438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 16439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 16440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 16441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 16442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 16443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 16444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 16445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 16446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 16447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 16448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 16449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 16450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 16451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 16452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 16453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 16454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 16455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 16456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 16457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 16458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 16459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 16460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 16461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 16462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 16463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 16464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 16465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 16466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 16467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 16468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 16469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 16470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 16471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 16472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 16473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 16474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 16475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 16476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 16477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 16478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 16479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 16480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 16481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 16482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 16483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 16484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 16485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 16486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 16487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 16488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 16489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 16490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 16491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 16492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 16493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 16494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 16495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 16496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 16497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 16498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 16499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 16500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 16501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 16502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 16503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 16504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 16505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 16506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 16507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 16508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 16509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 16510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 16511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 16512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 16513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 16514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 16515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 16516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 16517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 16518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 16519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 16520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 16521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 16522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 16523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 16524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 16525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 16526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 16527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 16528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 16529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 16530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 16531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 16532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 16533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 16534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 16535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 16536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 16537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 16538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 16539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 16540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 16541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 16542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 16543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 16544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 16545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 16546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 16547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 16548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 16549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 16550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 16551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 16552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 16553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 16554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 16555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 16556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 16557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 16558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 16559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 16560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 16561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 16562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 16563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 16564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 16565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 16566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 16567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 16568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 16569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 16570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 16571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 16572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 16573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 16574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 16575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 16576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 16577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 16578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 16579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 16580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 16581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 16582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 16583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 16584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 16585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 16586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 16587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 16588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 16589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 16590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 16591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 16592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 16593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 16594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 16595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 16596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 16597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 16598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 16599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 16600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 16601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 16602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 16603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 16604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 16605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 16606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 16607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 16608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 16609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 16610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 16611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 16612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 16613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 16614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 16615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 16616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 16617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 16618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 16619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 16620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 16621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 16622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 16623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 16624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 16625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 16626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 16627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 16628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 16629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 16630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 16631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 16632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 16633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 16634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 16635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 16636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 16637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 16638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 16639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 16640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 16641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 16642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 16643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 16644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 16645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 16646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 16647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 16648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 16649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 16650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 16651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 16652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 16653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 16654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 16655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 16656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 16657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 16658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 16659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 16660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 16661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 16662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 16663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 16664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 16665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 16666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 16667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 16668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 16669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 16670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 16671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 16672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 16673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 16674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 16675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 16676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 16677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 16678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 16679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 16680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 16681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 16682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 16683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 16684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 16685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 16686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 16687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 16688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 16689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 16690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 16691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 16692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 16693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 16694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 16695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 16696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 16697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 16698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 16699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 16700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 16701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 16702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 16703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 16704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 16705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 16706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 16707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 16708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 16709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 16710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 16711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 16712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 16713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 16714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 16715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 16716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 16717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 16718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 16719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 16720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 16721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 16722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 16723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 16724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 16725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 16726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 16727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 16728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 16729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 16730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 16731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 16732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 16733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 16734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 16735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 16736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 16737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 16738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 16739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 16740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 16741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 16742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 16743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 16744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 16745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 16746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 16747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 16748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 16749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 16750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 16751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 16752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 16753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 16754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 16755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 16756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 16757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 16758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 16759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 16760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 16761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 16762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 16763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 16764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 16765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 16766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 16767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 16768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 16769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 16770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 16771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 16772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 16773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 16774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 16775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 16776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 16777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 16778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 16779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 16780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 16781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 16782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 16783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 16784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 16785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 16786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 16787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 16788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 16789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 16790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 16791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 16792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 16793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 16794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 16795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 16796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 16797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 16798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 16799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 16800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 16801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 16802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 16803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 16804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 16805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 16806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 16807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 16808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 16809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 16810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 16811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 16812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 16813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 16814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 16815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 16816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 16817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 16818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 16819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 16820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 16821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 16822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 16823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 16824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 16825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 16826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 16827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 16828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 16829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 16830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 16831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 16832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 16833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 16834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 16835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 16836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 16837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 16838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 16839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 16840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 16841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 16842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 16843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 16844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 16845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 16846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 16847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 16848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 16849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 16850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 16851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 16852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 16853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 16854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 16855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 16856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 16857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 16858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 16859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 16860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 16861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 16862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 16863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 16864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 16865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 16866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 16867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 16868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 16869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 16870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 16871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 16872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 16873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 16874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 16875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 16876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 16877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 16878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 16879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 16880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 16881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 16882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 16883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 16884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 16885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 16886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 16887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 16888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 16889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 16890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 16891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 16892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 16893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 16894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 16895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 16896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 16897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 16898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 16899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 16900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 16901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 16902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 16903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 16904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 16905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 16906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 16907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 16908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 16909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 16910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 16911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 16912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 16913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 16914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 16915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 16916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 16917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 16918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 16919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 16920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 16921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 16922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 16923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 16924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 16925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 16926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 16927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 16928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 16929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 16930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 16931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 16932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 16933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 16934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 16935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 16936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 16937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 16938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 16939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 16940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 16941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 16942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 16943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 16944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 16945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 16946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 16947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 16948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 16949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 16950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 16951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 16952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 16953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 16954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 16955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 16956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 16957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 16958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 16959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 16960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 16961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 16962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 16963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 16964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 16965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 16966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 16967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 16968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 16969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 16970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 16971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 16972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 16973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 16974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 16975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 16976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 16977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 16978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 16979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 16980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 16981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 16982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 16983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 16984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 16985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 16986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 16987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 16988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 16989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 16990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 16991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 16992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 16993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 16994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 16995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 16996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 16997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 16998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 16999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 17000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 17001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 17002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 17003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 17004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 17005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 17006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 17007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 17008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 17009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 17010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 17011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 17012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 17013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 17014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 17015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 17016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 17017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 17018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 17019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 17020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 17021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 17022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 17023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 17024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 17025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 17026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 17027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 17028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 17029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 17030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 17031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 17032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 17033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 17034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 17035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 17036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 17037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 17038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 17039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 17040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 17041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 17042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 17043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 17044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 17045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 17046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 17047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 17048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 17049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 17050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 17051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 17052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 17053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 17054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 17055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 17056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 17057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 17058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 17059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 17060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 17061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 17062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 17063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 17064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 17065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 17066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 17067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 17068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 17069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 17070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 17071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 17072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 17073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 17074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 17075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 17076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 17077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 17078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 17079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 17080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 17081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 17082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 17083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 17084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 17085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 17086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 17087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 17088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 17089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 17090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 17091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 17092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 17093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 17094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 17095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 17096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 17097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 17098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 17099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 17100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 17101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 17102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 17103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 17104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 17105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 17106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 17107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 17108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 17109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 17110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 17111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 17112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 17113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 17114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 17115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 17116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 17117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 17118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 17119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 17120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 17121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 17122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 17123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 17124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 17125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 17126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 17127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 17128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 17129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 17130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 17131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 17132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 17133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 17134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 17135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 17136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 17137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 17138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 17139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 17140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 17141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 17142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 17143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 17144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 17145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 17146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 17147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 17148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 17149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 17150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 17151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 17152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 17153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 17154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 17155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 17156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 17157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 17158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 17159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 17160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 17161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 17162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 17163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 17164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 17165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 17166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 17167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 17168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 17169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 17170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 17171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 17172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 17173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 17174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 17175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 17176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 17177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 17178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 17179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 17180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 17181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 17182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 17183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 17184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 17185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 17186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 17187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 17188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 17189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 17190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 17191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 17192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 17193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 17194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 17195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 17196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 17197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 17198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 17199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 17200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 17201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 17202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 17203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 17204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 17205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 17206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 17207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 17208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 17209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 17210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 17211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 17212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 17213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 17214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 17215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 17216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 17217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 17218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 17219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 17220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 17221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 17222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 17223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 17224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 17225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 17226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 17227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 17228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 17229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 17230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 17231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 17232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 17233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 17234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 17235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 17236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 17237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 17238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 17239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 17240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 17241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 17242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 17243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 17244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 17245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 17246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 17247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 17248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 17249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 17250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 17251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 17252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 17253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 17254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 17255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 17256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 17257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 17258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 17259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 17260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 17261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 17262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 17263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 17264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 17265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 17266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 17267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 17268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 17269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 17270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 17271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 17272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 17273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 17274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 17275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 17276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 17277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 17278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 17279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 17280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 17281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 17282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 17283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 17284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 17285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 17286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 17287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 17288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 17289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 17290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 17291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 17292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 17293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 17294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 17295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 17296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 17297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 17298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 17299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 17300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 17301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 17302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 17303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 17304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 17305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 17306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 17307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 17308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 17309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 17310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 17311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 17312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 17313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 17314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 17315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 17316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 17317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 17318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 17319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 17320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 17321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 17322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 17323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 17324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 17325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 17326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 17327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 17328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 17329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 17330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 17331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 17332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 17333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 17334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 17335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 17336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 17337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 17338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 17339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 17340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 17341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 17342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 17343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 17344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 17345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 17346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 17347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 17348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 17349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 17350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 17351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 17352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 17353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 17354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 17355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 17356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 17357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 17358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 17359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 17360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 17361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 17362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 17363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 17364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 17365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 17366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 17367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 17368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 17369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 17370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 17371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 17372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 17373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 17374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 17375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 17376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 17377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 17378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 17379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 17380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 17381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 17382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 17383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 17384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 17385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 17386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 17387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 17388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 17389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 17390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 17391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 17392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 17393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 17394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 17395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 17396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 17397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 17398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 17399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 17400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 17401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 17402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 17403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 17404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 17405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 17406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 17407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 17408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 17409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 17410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 17411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 17412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 17413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 17414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 17415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 17416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 17417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 17418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 17419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 17420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 17421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 17422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 17423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 17424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 17425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 17426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 17427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 17428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 17429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 17430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 17431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 17432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 17433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 17434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 17435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 17436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 17437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 17438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 17439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 17440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 17441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 17442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHYHYRGYVEGVHNSSIALSDDFGLRGLLHLENASYGIEPLQNSSHFEHIIYRMDDVYKEPLKDGVSNKDIEKETAKDAAAEPPSMTQLLRR
